United States Patent 12,569,549 (FLAVIVIRUS VACCINE) - sequence listing, part 44

SEQ ID NO: 16253 - RNA, 9879 nt, synthetic construct
  misc_feature 1..9879: note = derived and/or modified CDS sequence (opt4) from DENV-1__FJ410191__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagcacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagggcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctggtgctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatcgaggcccagctgatcagacagatggagagcgaggagatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16254 - RNA, 9879 nt, synthetic construct
  misc_feature 1..9879: note = derived and/or modified CDS sequence (opt4) from DENV-1__FJ432723__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatcgccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcttcaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccggcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16255 - RNA, 9879 nt, synthetic construct
  misc_feature 1..9879: note = derived and/or modified CDS sequence (opt4) from DENV-1__FJ410192__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagccccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16256 - RNA, 9879 nt, synthetic construct
  misc_feature 1..9879: note = derived and/or modified CDS sequence (opt4) from DENV-1__FJ410194__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcccagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgagcccagaatcaccgacatcatggagcccgagcacgccctgctggccaagagcatcttcaagctgacctaccagaacaaggtggtgagagtgcagagccccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctggagccaccacttccaccagctgatcatgaaggacggcagagagatcgtggtgccctgcagaaaccaggacgagctggtgggcagagccagagtgagccagggcgccggctggagcctgagagagaccgcctgcctggccaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16257 - RNA, 9879 nt, synthetic construct
  misc_feature 1..9879: note = derived and/or modified CDS sequence (opt4) from DENV-1__FJ432725__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccggcgtgaccggcggcgtgaccctggtgttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggccaagggctggcccatcagcaagatggacatcggcgtgcccctgctggccctgggctgctacagccaggtgaaccccctgaccctgaccgcccccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggccccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctgggccacagagagagagagctgcacaagcagggcaagtgcgccacctgcgtgagcaacatgatgggcaagagagagaagaagctgggcgagttcggcaagcccaagggcagcagacccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagcagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16258 - RNA, 9879 nt, synthetic construct
  misc_feature 1..9879: note = derived and/or modified CDS sequence (opt4) from DENV-1__FJ432729__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctggccatgctgctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccagaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16259 - RNA, 9879 nt, synthetic construct
  misc_feature 1..9879: note = derived and/or modified CDS sequence (opt4) from DENV-1__FJ432730__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcatgaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16260 - RNA, 9879 nt, synthetic construct
  misc_feature 1..9879: note = derived and/or modified CDS sequence (opt4) from DENV-1__FJ432732__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcaccatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcttcgcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16261 - RNA, 9879 nt, synthetic construct
  misc_feature 1..9879: note = derived and/or modified CDS sequence (opt4) from DENV-1__FJ432733__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctggccatgctgctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccagaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16262 - RNA, 9879 nt, synthetic construct
  misc_feature 1..9879: note = derived and/or modified CDS sequence (opt4) from DENV-1__FJ410196__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccttcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcagcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagaggcatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16263 - RNA, 9879 nt, synthetic construct
  misc_feature 1..9879: note = derived and/or modified CDS sequence (opt4) from DENV-1__FJ432734__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggtgctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatgttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagaccgaccccgagggcgccctgtggtga

SEQ ID NO: 16264 - RNA, 9879 nt, synthetic construct
  misc_feature 1..9879: note = derived and/or modified CDS sequence (opt4) from DENV-1__FJ432735__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16265 - RNA, 9879 nt, synthetic construct
  misc_feature 1..9879: note = derived and/or modified CDS sequence (opt4) from DENV-1__FJ432736__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacctgacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggccccggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcatctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16266 - RNA, 9879 nt, synthetic construct
  misc_feature 1..9879: note = derived and/or modified CDS sequence (opt4) from DENV-1__FJ410198__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16267 - RNA, 9879 nt, synthetic construct
  misc_feature 1..9879: note = derived and/or modified CDS sequence (opt4) from DENV-1__FJ410199__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagaactacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgctgttcctgctgatcatgggccagctgacctggagcgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaaagtacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16268 - RNA, 9879 nt, synthetic construct
  misc_feature 1..9879: note = derived and/or modified CDS sequence (opt4) from DENV-1__FJ432739__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaaggcctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcatcctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagatcgaccccgagggcgccctgtggtga

SEQ ID NO: 16269 - RNA, 9879 nt, synthetic construct
  misc_feature 1..9879: note = derived and/or modified CDS sequence (opt4) from DENV-1__FJ410201__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctgaactacatgaccagcatgaagagattcaagaacgagagcgaccccgagggcgccctgtggtga

SEQ ID NO: 16270 - RNA, 9879 nt, synthetic construct
  misc_feature 1..9879: note = derived and/or modified CDS sequence (opt4) from DENV-1__FJ410203__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16271 - RNA, 9879 nt, synthetic construct
  misc_feature 1..9879: note = derived and/or modified CDS sequence (opt4) from DENV-1__FJ410204__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgtacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagaccaagaagctgagacacagatggcccgacgccagacagtacagcgaccccctgggcctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16272 - RNA, 9879 nt, synthetic construct
  misc_feature 1..9879: note = derived and/or modified CDS sequence (opt4) from DENV-1__FJ432742__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16273 - RNA, 9879 nt, synthetic construct
  misc_feature 1..9879: note = derived and/or modified CDS sequence (opt4) from DENV-1__FJ410205__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16274 - RNA, 9879 nt, synthetic construct
  misc_feature 1..9879: note = derived and/or modified CDS sequence (opt4) from DENV-1__FJ410207__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcatggtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagctggtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacagaatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16275 - RNA, 9879 nt, synthetic construct
  misc_feature 1..9879: note = derived and/or modified CDS sequence (opt4) from DENV-1__FJ432744__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaaggcctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcatcctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagagaagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagatcgaccccgagggcgccctgtggtga

SEQ ID NO: 16276 - RNA, 9879 nt, synthetic construct
  misc_feature 1..9879: note = derived and/or modified CDS sequence (opt4) from DENV-1__FJ547060__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctggtgagacagatggagagcgagggcatcttcagcccctgcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16277 - RNA, 9879 nt, synthetic construct
  misc_feature 1..9879: note = derived and/or modified CDS sequence (opt4) from DENV-1__FJ432745__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16278 - RNA, 9879 nt, synthetic construct
  misc_feature 1..9879: note = derived and/or modified CDS sequence (opt4) from DENV-1__FJ432746__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacaccaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16279 - RNA, 9879 nt, synthetic construct
  misc_feature 1..9879: note = derived and/or modified CDS sequence (opt4) from DENV-1__FJ432748__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaaggtgcccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16280 - RNA, 9879 nt, synthetic construct
  misc_feature 1..9879: note = derived and/or modified CDS sequence (opt4) from DENV-1__FJ432749__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagaaggccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcgtgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccttctggtga

SEQ ID NO: 16281 - RNA, 9879 nt, synthetic construct
  misc_feature 1..9879: note = derived and/or modified CDS sequence (opt4) from DENV-1__FJ410212__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgccctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcgtgacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16282 - RNA, 9879 nt, synthetic construct
  misc_feature 1..9879: note = derived and/or modified CDS sequence (opt4) from DENV-1__FJ461307__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgatcagcatgaagagattcaagaacgagagcgagcccgagggcgccctgtggtga

SEQ ID NO: 16283 - RNA, 9879 nt, synthetic construct
  misc_feature 1..9879: note = derived and/or modified CDS sequence (opt4) from DENV-1__FJ410213__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaaggacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16284 - RNA, 9879 nt, synthetic construct
  misc_feature 1..9879: note = derived and/or modified CDS sequence (opt4) from DENV-1__FJ461308__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctgcatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16285 - RNA, 9879 nt, synthetic construct
  misc_feature 1..9879: note = derived and/or modified CDS sequence (opt4) from DENV-1__FJ461310__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagagaaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatcgaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16286 - RNA, 9879 nt, synthetic construct
  misc_feature 1..9879: note = derived and/or modified CDS sequence (opt4) from DENV-1__FJ906728__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgatcctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggccccttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgctgagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacaccggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctggccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16287 - RNA, 9879 nt, synthetic construct
  misc_feature 1..9879: note = derived and/or modified CDS sequence (opt4) from DENV-1__FJ461313__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaagcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctgaactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16288 - RNA, 9879 nt, synthetic construct
  misc_feature 1..9879: note = derived and/or modified CDS sequence (opt4) from DENV-1__FJ547063__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgcagagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16289 - RNA, 9879 nt, synthetic construct
  misc_feature 1..9879: note = derived and/or modified CDS sequence (opt4) from DENV-1__FJ410218__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgtggagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16290 - RNA, 9879 nt, synthetic construct
  misc_feature 1..9879: note = derived and/or modified CDS sequence (opt4) from DENV-1__FJ461316__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatgggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16291 - RNA, 9879 nt, synthetic construct
  misc_feature 1..9879: note = derived and/or modified CDS sequence (opt4) from DENV-1__FJ410220__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcgtgttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16292 - RNA, 9879 nt, synthetic construct
  misc_feature 1..9879: note = derived and/or modified CDS sequence (opt4) from DENV-1__JF937649__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16293 - RNA, 9879 nt, synthetic construct
  misc_feature 1..9879: note = derived and/or modified CDS sequence (opt4) from DENV-1__FJ410222__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16294 - RNA, 9879 nt, synthetic construct
  misc_feature 1..9879: note = derived and/or modified CDS sequence (opt4) from DENV-1__FJ461319__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccgccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacgtgcaggtggccatcaaccaggtgagaagactgatcggcaacgagaactacctggactacatgaccagcatgaagagattcaagaacgagagcgaccccgagggcgccctgtggtga

SEQ ID NO: 16295 - RNA, 9879 nt, synthetic construct
  misc_feature 1..9879: note = derived and/or modified CDS sequence (opt4) from DENV-1__FJ461320__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatggtggaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatcagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16296 - RNA, 9879 nt, synthetic construct
  misc_feature 1..9879: note = derived and/or modified CDS sequence (opt4) from DENV-1__FJ410225__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgagatcagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgccagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16297 - RNA, 9879 nt, synthetic construct
  misc_feature 1..9879: note = derived and/or modified CDS sequence (opt4) from DENV-1__FJ410226__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggacaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcatgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16298 - RNA, 9879 nt, synthetic construct
  misc_feature 1..9879: note = derived and/or modified CDS sequence (opt4) from DENV-1__FJ410227__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcaccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16299 - RNA, 9879 nt, synthetic construct
  misc_feature 1..9879: note = derived and/or modified CDS sequence (opt4) from DENV-1__FJ859029__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagcacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagggcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctggtgctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggccaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16300 - RNA, 9879 nt, synthetic construct
  misc_feature 1..9879: note = derived and/or modified CDS sequence (opt4) from DENV-1__FJ547065__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgacctgagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaaagtggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16301 - RNA, 9879 nt, synthetic construct
  misc_feature 1..9879: note = derived and/or modified CDS sequence (opt4) from DENV-1__FJ410230__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgatcggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatgagcagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcagaatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagactgaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16302 - RNA, 9879 nt, synthetic construct
  misc_feature 1..9879: note = derived and/or modified CDS sequence (opt4) from DENV-1__FJ410231__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16303 - RNA, 9879 nt, synthetic construct
  misc_feature 1..9879: note = derived and/or modified CDS sequence (opt4) from DENV-1__FJ461323__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggtgctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagaccgaccccgagggcgccctgtggtga

SEQ ID NO: 16304 - RNA, 9879 nt, synthetic construct
  misc_feature 1..9879: note = derived and/or modified CDS sequence (opt4) from DENV-1__FJ461325__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16305 - RNA, 9879 nt, synthetic construct
  misc_feature 1..9879: note = derived and/or modified CDS sequence (opt4) from DENV-1__FJ410232__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16306 - RNA, 9879 nt, synthetic construct
  misc_feature 1..9879: note = derived and/or modified CDS sequence (opt4) from DENV-1__FJ461327__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16307 - RNA, 9879 nt, synthetic construct
  misc_feature 1..9879: note = derived and/or modified CDS sequence (opt4) from DENV-1__FJ461328__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16308 - RNA, 9879 nt, synthetic construct
  misc_feature 1..9879: note = derived and/or modified CDS sequence (opt4) from DENV-1__FJ410234__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccagcagcctggaggagctgggcgacggcctggccatgggcatcatgatcctgaagctgctgaccgacttccagagccaccagctgtgggccaccctgctgagcctgaccttcatcaagaccgccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16309 - RNA, 9879 nt, synthetic construct
  misc_feature 1..9879: note = derived and/or modified CDS sequence (opt4) from DENV-1__FJ410235__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccaccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcgtgcccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccatcatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgggcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16310 - RNA, 9879 nt, synthetic construct
  misc_feature 1..9879: note = derived and/or modified CDS sequence (opt4) from DENV-1__FJ410236__SS-prME
  source 1..9879: mol_type = other RNA
agcgtgaccatgctgctgatgctggtgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccatgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtgaagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16311 - RNA, 9879 nt, synthetic construct
  misc_feature 1..9879: note = derived and/or modified CDS sequence (opt4) from DENV-1__FJ410238__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacaccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagtgtacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16312 - RNA, 9879 nt, synthetic construct
  misc_feature 1..9879: note = derived and/or modified CDS sequence (opt4) from DENV-1__FJ410239__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgttcctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16313 - RNA, 9879 nt, synthetic construct
  misc_feature 1..9879: note = derived and/or modified CDS sequence (opt4) from DENV-1__FJ410240__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgcccacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16314 - RNA, 9879 nt, synthetic construct
  misc_feature 1..9879: note = derived and/or modified CDS sequence (opt4) from DENV-1__FJ410242__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcaccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16315 - RNA, 9879 nt, synthetic construct
  misc_feature 1..9879: note = derived and/or modified CDS sequence (opt4) from DENV-1__FJ410243__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaaggcctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggccccatgaagatcaaggacgaggagagagacgacatgctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatcctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagatcgaccccgagggcgccctgtggtga

SEQ ID NO: 16316 - RNA, 9879 nt, synthetic construct
  misc_feature 1..9879: note = derived and/or modified CDS sequence (opt4) from DENV-1__FJ410244__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatgaacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaacctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccatcatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtgcccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16317 - RNA, 9879 nt, synthetic construct
  misc_feature 1..9879: note = derived and/or modified CDS sequence (opt4) from DENV-1__FJ410245__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacatcggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagaagaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16318 - RNA, 9879 nt, synthetic construct
  misc_feature 1..9879: note = derived and/or modified CDS sequence (opt4) from DENV-1__FJ410246__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggacaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgaccgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgcacgaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagagacacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16319 - RNA, 9879 nt, synthetic construct
  misc_feature 1..9879: note = derived and/or modified CDS sequence (opt4) from DENV-1__FJ410247__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacagaatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagcagggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16320 - RNA, 9879 nt, synthetic construct
  misc_feature 1..9879: note = derived and/or modified CDS sequence (opt4) from DENV-1__FJ410248__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgtggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccacctacagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16321 - RNA, 9879 nt, synthetic construct
  misc_feature 1..9879: note = derived and/or modified CDS sequence (opt4) from DENV-1__FJ410249__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagagaagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcgtgggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcttcctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccaccggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16322 - RNA, 9879 nt, synthetic construct
  misc_feature 1..9879: note = derived and/or modified CDS sequence (opt4) from DENV-1__FJ410251__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcggcaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16323 - RNA, 9879 nt, synthetic construct
  misc_feature 1..9879: note = derived and/or modified CDS sequence (opt4) from DENV-1__FJ410252__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgactacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16324 - RNA, 9879 nt, synthetic construct
  misc_feature 1..9879: note = derived and/or modified CDS sequence (opt4) from DENV-1__FJ461331__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgtggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16325 - RNA, 9879 nt, synthetic construct
  misc_feature 1..9879: note = derived and/or modified CDS sequence (opt4) from DENV-1__FJ410256__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcaccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtggtggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16326 - RNA, 9879 nt, synthetic construct
  misc_feature 1..9879: note = derived and/or modified CDS sequence (opt4) from DENV-1__FJ410257__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcaccacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttcagcggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaactacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgacagaaagaagctgagacccagatggctggacgccagaacctacagcgaccccctggccctgagagagctgaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16327 - RNA, 9879 nt, synthetic construct
  misc_feature 1..9879: note = derived and/or modified CDS sequence (opt4) from DENV-1__FJ461332__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgtggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgtgaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16328 - RNA, 9879 nt, synthetic construct
  misc_feature 1..9879: note = derived and/or modified CDS sequence (opt4) from DENV-1__FJ461333__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacgtgcaggtggccatcaaccaggtgagaagactgatcggcaacgagaactacctggactacatgaccagcatgaagagattcaagaacgagagcgaccccgagggcgccctgtggtga

SEQ ID NO: 16329 - RNA, 9879 nt, synthetic construct
  misc_feature 1..9879: note = derived and/or modified CDS sequence (opt4) from DENV-1__FJ410262__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcggcctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16330 - RNA, 9879 nt, synthetic construct
  misc_feature 1..9879: note = derived and/or modified CDS sequence (opt4) from DENV-1__FJ410263__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacatcatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16331 - RNA, 9879 nt, synthetic construct
  misc_feature 1..9879: note = derived and/or modified CDS sequence (opt4) from DENV-1__FJ410264__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16332 - RNA, 9879 nt, synthetic construct
  misc_feature 1..9879: note = derived and/or modified CDS sequence (opt4) from DENV-1__FJ410265__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16333 - RNA, 9879 nt, synthetic construct
  misc_feature 1..9879: note = derived and/or modified CDS sequence (opt4) from DENV-1__FJ461336__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgctgaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16334 - RNA, 9879 nt, synthetic construct
  misc_feature 1..9879: note = derived and/or modified CDS sequence (opt4) from DENV-1__FJ410266__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcaagaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatcgccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcttcaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccggcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16335 - RNA, 9879 nt, synthetic construct
  misc_feature 1..9879: note = derived and/or modified CDS sequence (opt4) from DENV-1__FJ410269__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagatccccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16336 - RNA, 9879 nt, synthetic construct
  misc_feature 1..9879: note = derived and/or modified CDS sequence (opt4) from DENV-1__FJ410273__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgtggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctgacccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccacctacagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16337 - RNA, 9879 nt, synthetic construct
  misc_feature 1..9879: note = derived and/or modified CDS sequence (opt4) from DENV-1__FJ410276__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccagagccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16338 - RNA, 9879 nt, synthetic construct
  misc_feature 1..9879: note = derived and/or modified CDS sequence (opt4) from DENV-1__FJ410278__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagagaaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16339 - RNA, 9879 nt, synthetic construct
  misc_feature 1..9879: note = derived and/or modified CDS sequence (opt4) from DENV-1__FJ410279__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcctgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagagtgtacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16340 - RNA, 9879 nt, synthetic construct
  misc_feature 1..9879: note = derived and/or modified CDS sequence (opt4) from DENV-1__FJ410283__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16341 - RNA, 9879 nt, synthetic construct
  misc_feature 1..9879: note = derived and/or modified CDS sequence (opt4) from DENV-1__FJ410284__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagaaggacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccaccaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16342 - RNA, 9879 nt, synthetic construct
  misc_feature 1..9879: note = derived and/or modified CDS sequence (opt4) from DENV-1__FJ410285__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagcacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgagcctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggccccggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctggccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16343 - RNA, 9879 nt, synthetic construct
  misc_feature 1..9879: note = derived and/or modified CDS sequence (opt4) from DENV-1__FJ410286__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacggcaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16344 - RNA, 9879 nt, synthetic construct
  misc_feature 1..9879: note = derived and/or modified CDS sequence (opt4) from DENV-1__FJ461339__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatcgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgtgggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagaccagcaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16345 - RNA, 9879 nt, synthetic construct
  misc_feature 1..9879: note = derived and/or modified CDS sequence (opt4) from DENV-1__FJ882515__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggccccaggtgccccactgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgaggacgaccccgagggcgccctgtggtga

SEQ ID NO: 16346 - RNA, 9879 nt, synthetic construct
  misc_feature 1..9879: note = derived and/or modified CDS sequence (opt4) from DENV-1__FJ882517__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgaggaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggtgaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16347 - RNA, 9879 nt, synthetic construct
  misc_feature 1..9879: note = derived and/or modified CDS sequence (opt4) from DENV-1__JQ287661__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16348 - RNA, 9879 nt, synthetic construct
  misc_feature 1..9879: note = derived and/or modified CDS sequence (opt4) from DENV-1__FJ882518__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccagcacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16349 - RNA, 9879 nt, synthetic construct
  misc_feature 1..9879: note = derived and/or modified CDS sequence (opt4) from DENV-1__FJ882519__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaagacacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16350 - RNA, 9879 nt, synthetic construct
  misc_feature 1..9879: note = derived and/or modified CDS sequence (opt4) from DENV-1__FJ882520__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16351 - RNA, 9879 nt, synthetic construct
  misc_feature 1..9879: note = derived and/or modified CDS sequence (opt4) from DENV-1__FJ882523__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacgaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16352 - RNA, 9879 nt, synthetic construct
  misc_feature 1..9879: note = derived and/or modified CDS sequence (opt4) from DENV-1__FJ882524__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaactacgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgaccgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16353 - RNA, 9879 nt, synthetic construct
  misc_feature 1..9879: note = derived and/or modified CDS sequence (opt4) from DENV-1__FJ882525__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctggtggccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcagatacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatcggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacttcgtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16354 - RNA, 9879 nt, synthetic construct
  misc_feature 1..9879: note = derived and/or modified CDS sequence (opt4) from DENV-1__FJ882526__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagagagccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16355 - RNA, 9879 nt, synthetic construct
  misc_feature 1..9879: note = derived and/or modified CDS sequence (opt4) from DENV-1__FJ882527__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctggccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16356 - RNA, 9879 nt, synthetic construct
  misc_feature 1..9879: note = derived and/or modified CDS sequence (opt4) from DENV-1__FJ882529__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacgtgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggtgcacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16357 - RNA, 9879 nt, synthetic construct
  misc_feature 1..9879: note = derived and/or modified CDS sequence (opt4) from DENV-1__FJ882530__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16358 - RNA, 9879 nt, synthetic construct
  misc_feature 1..9879: note = derived and/or modified CDS sequence (opt4) from DENV-1__GQ868605__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgacacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgagcatcagcatcatgatcgaggaggtgatgagaagcagatggagcagaaagatgctgatgaccggcaccctggccgtgttcctgctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccgccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgagaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggcagcgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcatcgagatcggcaagctgccccagcacctgacccagaaggcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16359 - RNA, 9879 nt, synthetic construct
  misc_feature 1..9879: note = derived and/or modified CDS sequence (opt4) from DENV-1__FJ882534__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcccccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgtggagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16360 - RNA, 9879 nt, synthetic construct
  misc_feature 1..9879: note = derived and/or modified CDS sequence (opt4) from DENV-1__FJ882536__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16361 - RNA, 9879 nt, synthetic construct
  misc_feature 1..9879: note = derived and/or modified CDS sequence (opt4) from DENV-1__FJ882537__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccaccggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatggtgagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcacatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16362 - RNA, 9879 nt, synthetic construct
  misc_feature 1..9879: note = derived and/or modified CDS sequence (opt4) from DENV-1__GQ868606__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16363 - RNA, 9879 nt, synthetic construct
  misc_feature 1..9879: note = derived and/or modified CDS sequence (opt4) from DENV-1__FJ882539__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccctggccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcatcacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16364 - RNA, 9879 nt, synthetic construct
  misc_feature 1..9879: note = derived and/or modified CDS sequence (opt4) from DENV-1__FJ882541__SS-prME
  source 1..9879: mol_type = other RNA
agcgtgaccatgctgctgatgctgatccccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaagggcaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16365 - RNA, 9879 nt, synthetic construct
  misc_feature 1..9879: note = derived and/or modified CDS sequence (opt4) from DENV-1__FJ882542__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccagcacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcatgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16366 - RNA, 9879 nt, synthetic construct
  misc_feature 1..9879: note = derived and/or modified CDS sequence (opt4) from DENV-1__FJ882543__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccgccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttcctgggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16367 - RNA, 9879 nt, synthetic construct
  misc_feature 1..9879: note = derived and/or modified CDS sequence (opt4) from DENV-1__FJ882544__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaagggcaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16368 - RNA, 9879 nt, synthetic construct
  misc_feature 1..9879: note = derived and/or modified CDS sequence (opt4) from DENV-1__FJ898371__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccagaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16369 - RNA, 9879 nt, synthetic construct
  misc_feature 1..9879: note = derived and/or modified CDS sequence (opt4) from DENV-1__FJ882545__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16370 - RNA, 9879 nt, synthetic construct
  misc_feature 1..9879: note = derived and/or modified CDS sequence (opt4) from DENV-1__FJ898372__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccagagacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16371 - RNA, 9879 nt, synthetic construct
  misc_feature 1..9879: note = derived and/or modified CDS sequence (opt4) from DENV-1__FJ898373__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccaccggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccgtgggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatggtgagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcacatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16372 - RNA, 9879 nt, synthetic construct
  misc_feature 1..9879: note = derived and/or modified CDS sequence (opt4) from DENV-1__FJ898374__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16373 - RNA, 9879 nt, synthetic construct
  misc_feature 1..9879: note = derived and/or modified CDS sequence (opt4) from DENV-1__FJ898375__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagccacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaagcaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16374 - RNA, 9879 nt, synthetic construct
  misc_feature 1..9879: note = derived and/or modified CDS sequence (opt4) from DENV-1__FJ898376__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctggccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccagaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccaactgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16375 - RNA, 9879 nt, synthetic construct
  misc_feature 1..9879: note = derived and/or modified CDS sequence (opt4) from DENV-1__FJ898379__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16376 - RNA, 9879 nt, synthetic construct
  misc_feature 1..9879: note = derived and/or modified CDS sequence (opt4) from DENV-1__GQ199773__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgaccgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctggaacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16377 - RNA, 9879 nt, synthetic construct
  misc_feature 1..9879: note = derived and/or modified CDS sequence (opt4) from DENV-1__JF937596__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16378 - RNA, 9879 nt, synthetic construct
  misc_feature 1..9879: note = derived and/or modified CDS sequence (opt4) from DENV-1__FJ898380__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16379 - RNA, 9879 nt, synthetic construct
  misc_feature 1..9879: note = derived and/or modified CDS sequence (opt4) from DENV-1__FJ898382__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccttcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcagcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16380 - RNA, 9879 nt, synthetic construct
  misc_feature 1..9879: note = derived and/or modified CDS sequence (opt4) from DENV-1__FJ898383__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccatcaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16381 - RNA, 9879 nt, synthetic construct
  misc_feature 1..9879: note = derived and/or modified CDS sequence (opt4) from DENV-1__FJ898384__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccatcttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16382 - RNA, 9879 nt, synthetic construct
  misc_feature 1..9879: note = derived and/or modified CDS sequence (opt4) from DENV-1__FJ898385__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcggcgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacatgggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16383 - RNA, 9879 nt, synthetic construct
  misc_feature 1..9879: note = derived and/or modified CDS sequence (opt4) from DENV-1__GQ868608__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaaggcctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctggaaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacatgctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagatcgaccccgagggcgccctgtggtga

SEQ ID NO: 16384 - RNA, 9879 nt, synthetic construct
  misc_feature 1..9879: note = derived and/or modified CDS sequence (opt4) from DENV-1__GQ199774__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccaccggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatggtgagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgagagagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcacatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16385 - RNA, 9879 nt, synthetic construct
  misc_feature 1..9879: note = derived and/or modified CDS sequence (opt4) from DENV-1__GQ199775__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccaccggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatggtgagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgagagagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcacatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctggaccagagaggaggtgaccagaaaggtgagaagcaacgccggcatcggcgccggcgtgggcgacgagaaccagtggaacagcgccaagaagggcgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16386 - RNA, 9876 nt, synthetic construct
  misc_feature 1..9876: note = derived and/or modified CDS sequence (opt4) from DENV-1__FJ882546__SS-prME
  source 1..9876: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaaagagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgagctgcacctgggccagcagagagtgttcaaggagaaggtggacaccagaacccccagagccaagagaggcaccgcccagatcatggagatgaccgccagatggctgtggggcttcctgagcagaaacaagatccccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16387 - RNA, 9879 nt, synthetic construct
  misc_feature 1..9879: note = derived and/or modified CDS sequence (opt4) from DENV-1__KF921935__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaaggagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16388 - RNA, 9879 nt, synthetic construct
  misc_feature 1..9879: note = derived and/or modified CDS sequence (opt4) from DENV-1__GQ199776__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggtggtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16389 - RNA, 9879 nt, synthetic construct
  misc_feature 1..9879: note = derived and/or modified CDS sequence (opt4) from DENV-1__GQ199777__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcctgttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctggccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16390 - RNA, 9879 nt, synthetic construct
  misc_feature 1..9879: note = derived and/or modified CDS sequence (opt4) from DENV-1__GQ199778__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggaggcctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccatcaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16391 - RNA, 9879 nt, synthetic construct
  misc_feature 1..9879: note = derived and/or modified CDS sequence (opt4) from DENV-1__GQ199780__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16392 - RNA, 9879 nt, synthetic construct
  misc_feature 1..9879: note = derived and/or modified CDS sequence (opt4) from DENV-1__GQ199781__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcatcagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccagaagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16393 - RNA, 9879 nt, synthetic construct
  misc_feature 1..9879: note = derived and/or modified CDS sequence (opt4) from DENV-1__GQ199782__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacatccagaacaccaccttcatcatcgacggccccaacacccccgagtgccccgacgaccagagagcctggaacatctgggaggtggaggactacggcttcggcatcttcaccaccaacatctggctgagactgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatggtggaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatcagacccatgttcgccgtgggcctgctggtgagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatgaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16394 - RNA, 9879 nt, synthetic construct
  misc_feature 1..9879: note = derived and/or modified CDS sequence (opt4) from DENV-1__GQ199783__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcaccagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcagcaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatcagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcaccacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16395 - RNA, 9879 nt, synthetic construct
  misc_feature 1..9879: note = derived and/or modified CDS sequence (opt4) from DENV-1__GQ199784__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctggccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccagaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16396 - RNA, 9879 nt, synthetic construct
  misc_feature 1..9879: note = derived and/or modified CDS sequence (opt4) from DENV-1__GQ199785__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatgaagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16397 - RNA, 9879 nt, synthetic construct
  misc_feature 1..9879: note = derived and/or modified CDS sequence (opt4) from DENV-1__GQ199786__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgatcctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16398 - RNA, 9879 nt, synthetic construct
  misc_feature 1..9879: note = derived and/or modified CDS sequence (opt4) from DENV-1__GQ199787__SS-prME
  source 1..9879: mol_type = other RNA
agcgtgaccatgctgctgatgctggtgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcctgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaacgaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16399 - RNA, 9879 nt, synthetic construct
  misc_feature 1..9879: note = derived and/or modified CDS sequence (opt4) from DENV-1__GQ199788__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16400 - RNA, 9879 nt, synthetic construct
  misc_feature 1..9879: note = derived and/or modified CDS sequence (opt4) from DENV-1__GQ199789__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagcacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagggcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctggtgctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatcgaggcccagctgatcagacagatggagagcgaggagatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16401 - RNA, 9879 nt, synthetic construct
  misc_feature 1..9879: note = derived and/or modified CDS sequence (opt4) from DENV-1__GQ199790__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctggccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccagaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16402 - RNA, 9879 nt, synthetic construct
  misc_feature 1..9879: note = derived and/or modified CDS sequence (opt4) from DENV-1__GQ199791__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcgtgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccttctggtga

SEQ ID NO: 16403 - RNA, 9879 nt, synthetic construct
  misc_feature 1..9879: note = derived and/or modified CDS sequence (opt4) from DENV-1__GQ199792__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacgcctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacatgggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccggcgactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16404 - RNA, 9879 nt, synthetic construct
  misc_feature 1..9879: note = derived and/or modified CDS sequence (opt4) from DENV-1__GQ199793__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccaccaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacgccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16405 - RNA, 9879 nt, synthetic construct
  misc_feature 1..9879: note = derived and/or modified CDS sequence (opt4) from DENV-1__GQ199795__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggaccccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16406 - RNA, 9873 nt, synthetic construct
  misc_feature 1..9873: note = derived and/or modified CDS sequence (opt4) from DENV-1__FJ882547__SS-prME
  source 1..9873: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatcggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagggcaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatgagccccatcgccatgaccgacaccacccccctggcccagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16407 - RNA, 9879 nt, synthetic construct
  misc_feature 1..9879: note = derived and/or modified CDS sequence (opt4) from DENV-1__GQ199797__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccatgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16408 - RNA, 9879 nt, synthetic construct
  misc_feature 1..9879: note = derived and/or modified CDS sequence (opt4) from DENV-1__GQ199799__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16409 - RNA, 9879 nt, synthetic construct
  misc_feature 1..9879: note = derived and/or modified CDS sequence (opt4) from DENV-1__GQ199800__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16410 - RNA, 9879 nt, synthetic construct
  misc_feature 1..9879: note = derived and/or modified CDS sequence (opt4) from DENV-1__FJ882548__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16411 - RNA, 9879 nt, synthetic construct
  misc_feature 1..9879: note = derived and/or modified CDS sequence (opt4) from DENV-1__GQ199801__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccagactggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcaagaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccacctacagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatccccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16412 - RNA, 9879 nt, synthetic construct
  misc_feature 1..9879: note = derived and/or modified CDS sequence (opt4) from DENV-1__GQ199802__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtgggtgttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16413 - RNA, 9879 nt, synthetic construct
  misc_feature 1..9879: note = derived and/or modified CDS sequence (opt4) from DENV-1__JF937597__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctgaactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16414 - RNA, 9879 nt, synthetic construct
  misc_feature 1..9879: note = derived and/or modified CDS sequence (opt4) from DENV-1__GQ868609__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgagactgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16415 - RNA, 9879 nt, synthetic construct
  misc_feature 1..9879: note = derived and/or modified CDS sequence (opt4) from DENV-1__GQ199803__SS-prME
  source 1..9879: mol_type = other RNA
agcgtgaccatgctgctgatgctgatgcccaccgccctggccttccacctgaccatcagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccagcagcctggaggagctgggcgacggcctggccatgggcatcatgatcctgaagctgctgaccgacttccagagccaccagctgtgggccaccctgctgagcctgaccttcatcaagaccgccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgacagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16416 - RNA, 9879 nt, synthetic construct
  misc_feature 1..9879: note = derived and/or modified CDS sequence (opt4) from DENV-1__GQ199804__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgacgccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16417 - RNA, 9879 nt, synthetic construct
  misc_feature 1..9879: note = derived and/or modified CDS sequence (opt4) from DENV-1__GQ199805__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctggccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccagaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16418 - RNA, 9879 nt, synthetic construct
  misc_feature 1..9879: note = derived and/or modified CDS sequence (opt4) from DENV-1__GQ199806__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggccgtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgtggtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggacggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgaacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16419 - RNA, 9879 nt, synthetic construct
  misc_feature 1..9879: note = derived and/or modified CDS sequence (opt4) from DENV-1__GQ199809__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccaactgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16420 - RNA, 9879 nt, synthetic construct
  misc_feature 1..9879: note = derived and/or modified CDS sequence (opt4) from DENV-1__GQ199810__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggtggagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16421 - RNA, 9879 nt, synthetic construct
  misc_feature 1..9879: note = derived and/or modified CDS sequence (opt4) from DENV-1__GQ199811__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16422 - RNA, 9879 nt, synthetic construct
  misc_feature 1..9879: note = derived and/or modified CDS sequence (opt4) from DENV-1__FJ882549__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgctgaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16423 - RNA, 9879 nt, synthetic construct
  misc_feature 1..9879: note = derived and/or modified CDS sequence (opt4) from DENV-1__GQ199814__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggacaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgaccgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16424 - RNA, 9879 nt, synthetic construct
  misc_feature 1..9879: note = derived and/or modified CDS sequence (opt4) from DENV-1__GQ199816__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaaggcctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcatcctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagatcgaccccgagggcgccctgtggtga

SEQ ID NO: 16425 - RNA, 9879 nt, synthetic construct
  misc_feature 1..9879: note = derived and/or modified CDS sequence (opt4) from DENV-1__GQ199817__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtgcttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcctgctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16426 - RNA, 9879 nt, synthetic construct
  misc_feature 1..9879: note = derived and/or modified CDS sequence (opt4) from DENV-1__FJ882550__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcatgaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16427 - RNA, 9879 nt, synthetic construct
  misc_feature 1..9879: note = derived and/or modified CDS sequence (opt4) from DENV-1__FJ882551__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatcggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagccacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcaggagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctgaagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagctggtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16428 - RNA, 9879 nt, synthetic construct
  misc_feature 1..9879: note = derived and/or modified CDS sequence (opt4) from DENV-1__FJ882552__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccagcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaaccacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16429 - RNA, 9879 nt, synthetic construct
  misc_feature 1..9879: note = derived and/or modified CDS sequence (opt4) from DENV-1__FJ882553__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcagaaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgagcccgagggcgccctgtggtga

SEQ ID NO: 16430 - RNA, 9879 nt, synthetic construct
  misc_feature 1..9879: note = derived and/or modified CDS sequence (opt4) from DENV-1__FJ882554__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgacccctacagcatcgccgccagaggctacatcagcaccagagtgggcatgggcgaggccgccgccatcttcatgaccgccaccccccccggcagcgtggaggccttcccccagagcaacgccgtgatcaaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16431 - RNA, 9879 nt, synthetic construct
  misc_feature 1..9879: note = derived and/or modified CDS sequence (opt4) from DENV-1__GQ868610__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatcgccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcttcaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16432 - RNA, 9879 nt, synthetic construct
  misc_feature 1..9879: note = derived and/or modified CDS sequence (opt4) from DENV-1__GQ868611__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccagagccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16433 - RNA, 9879 nt, synthetic construct
  misc_feature 1..9879: note = derived and/or modified CDS sequence (opt4) from DENV-1__FJ882555__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcgccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccagaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaaggtggtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16434 - RNA, 9879 nt, synthetic construct
  misc_feature 1..9879: note = derived and/or modified CDS sequence (opt4) from DENV-1__GQ199821__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgtggtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatcgccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16435 - RNA, 9879 nt, synthetic construct
  misc_feature 1..9879: note = derived and/or modified CDS sequence (opt4) from DENV-1__FJ882556__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgagcgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16436 - RNA, 9879 nt, synthetic construct
  misc_feature 1..9879: note = derived and/or modified CDS sequence (opt4) from DENV-1__GQ199822__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcagagccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccctggtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16437 - RNA, 9879 nt, synthetic construct
  misc_feature 1..9879: note = derived and/or modified CDS sequence (opt4) from DENV-1__FJ882557__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccatgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16438 - RNA, 9879 nt, synthetic construct
  misc_feature 1..9879: note = derived and/or modified CDS sequence (opt4) from DENV-1__FJ882558__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctgaccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccatgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16439 - RNA, 9879 nt, synthetic construct
  misc_feature 1..9879: note = derived and/or modified CDS sequence (opt4) from DENV-1__GQ199824__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcctgaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16440 - RNA, 9879 nt, synthetic construct
  misc_feature 1..9879: note = derived and/or modified CDS sequence (opt4) from DENV-1__FJ882559__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccagaatcatcggcgccgacgtgcagaacaccaccttcatcatcgacggccccaacacccccgagtgccccgacgaccagagagcctggaacatctgggaggtggaggactacggcttcggcatcttcaccaccaacatctggctgagactgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcgtgcacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgagactgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16441 - RNA, 9879 nt, synthetic construct
  misc_feature 1..9879: note = derived and/or modified CDS sequence (opt4) from DENV-1__GQ199828__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgagagagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgatcggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaagaacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgacaaggccatcggcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16442 - RNA, 9879 nt, synthetic construct
  misc_feature 1..9879: note = derived and/or modified CDS sequence (opt4) from DENV-1__GQ199829__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16443 - RNA, 9879 nt, synthetic construct
  misc_feature 1..9879: note = derived and/or modified CDS sequence (opt4) from DENV-1__FJ882562__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatgaccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16444 - RNA, 9879 nt, synthetic construct
  misc_feature 1..9879: note = derived and/or modified CDS sequence (opt4) from DENV-1__FJ882564__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatggtggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16445 - RNA, 9879 nt, synthetic construct
  misc_feature 1..9879: note = derived and/or modified CDS sequence (opt4) from DENV-1__FJ882565__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagaggcagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16446 - RNA, 9879 nt, synthetic construct
  misc_feature 1..9879: note = derived and/or modified CDS sequence (opt4) from DENV-1__FJ882567__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16447 - RNA, 9879 nt, synthetic construct
  misc_feature 1..9879: note = derived and/or modified CDS sequence (opt4) from DENV-1__GQ199831__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgaccccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16448 - RNA, 9879 nt, synthetic construct
  misc_feature 1..9879: note = derived and/or modified CDS sequence (opt4) from DENV-1__GQ199832__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacaagcacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16449 - RNA, 9879 nt, synthetic construct
  misc_feature 1..9879: note = derived and/or modified CDS sequence (opt4) from DENV-1__FJ882568__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccgtggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16450 - RNA, 9879 nt, synthetic construct
  misc_feature 1..9879: note = derived and/or modified CDS sequence (opt4) from DENV-1__FJ882569__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16451 - RNA, 9879 nt, synthetic construct
  misc_feature 1..9879: note = derived and/or modified CDS sequence (opt4) from DENV-1__GQ199833__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacagaagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaagggcaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16452 - RNA, 9879 nt, synthetic construct
  misc_feature 1..9879: note = derived and/or modified CDS sequence (opt4) from DENV-1__FJ882570__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacggcaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcttcgtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgccctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16453 - RNA, 9879 nt, synthetic construct
  misc_feature 1..9879: note = derived and/or modified CDS sequence (opt4) from DENV-1__GQ199834__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggacggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16454 - RNA, 9879 nt, synthetic construct
  misc_feature 1..9879: note = derived and/or modified CDS sequence (opt4) from DENV-1__GQ199835__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctgaccctgatggccaccttcaagatgagacccatgttcgccgtgggcctgctgctgagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16455 - RNA, 9879 nt, synthetic construct
  misc_feature 1..9879: note = derived and/or modified CDS sequence (opt4) from DENV-1__FJ898386__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccttctggtga

SEQ ID NO: 16456 - RNA, 9879 nt, synthetic construct
  misc_feature 1..9879: note = derived and/or modified CDS sequence (opt4) from DENV-1__FJ898387__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16457 - RNA, 9879 nt, synthetic construct
  misc_feature 1..9879: note = derived and/or modified CDS sequence (opt4) from DENV-1__FJ898389__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgttcctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcttcggctgcaagcccctggccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccttcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16458 - RNA, 9879 nt, synthetic construct
  misc_feature 1..9879: note = derived and/or modified CDS sequence (opt4) from DENV-1__FJ898390__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16459 - RNA, 9879 nt, synthetic construct
  misc_feature 1..9879: note = derived and/or modified CDS sequence (opt4) from DENV-1__FJ898391__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16460 - RNA, 9879 nt, synthetic construct
  misc_feature 1..9879: note = derived and/or modified CDS sequence (opt4) from DENV-1__FJ898392__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16461 - RNA, 9879 nt, synthetic construct
  misc_feature 1..9879: note = derived and/or modified CDS sequence (opt4) from DENV-1__FJ898393__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16462 - RNA, 9879 nt, synthetic construct
  misc_feature 1..9879: note = derived and/or modified CDS sequence (opt4) from DENV-1__FJ898394__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccccccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16463 - RNA, 9879 nt, synthetic construct
  misc_feature 1..9879: note = derived and/or modified CDS sequence (opt4) from DENV-1__GQ199838__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccctggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16464 - RNA, 9879 nt, synthetic construct
  misc_feature 1..9879: note = derived and/or modified CDS sequence (opt4) from DENV-1__FJ898396__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcaccctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16465 - RNA, 9879 nt, synthetic construct
  misc_feature 1..9879: note = derived and/or modified CDS sequence (opt4) from DENV-1__GQ199839__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagcagaaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcctgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcttcgtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgccctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16466 - RNA, 9879 nt, synthetic construct
  misc_feature 1..9879: note = derived and/or modified CDS sequence (opt4) from DENV-1__FJ898397__SS-prME
  source 1..9879: mol_type = other RNA
agcgtgaccatgctgctgatgctgatgcccaccgccctggccttccacctgaccatcagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16467 - RNA, 9879 nt, synthetic construct
  misc_feature 1..9879: note = derived and/or modified CDS sequence (opt4) from DENV-1__FJ898398__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagatctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagagcatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctgaactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16468 - RNA, 9879 nt, synthetic construct
  misc_feature 1..9879: note = derived and/or modified CDS sequence (opt4) from DENV-1__FJ898399__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaagacacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16469 - RNA, 9879 nt, synthetic construct
  misc_feature 1..9879: note = derived and/or modified CDS sequence (opt4) from DENV-1__FJ898401__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacggccactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagaaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccacggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16470 - RNA, 9879 nt, synthetic construct
  misc_feature 1..9879: note = derived and/or modified CDS sequence (opt4) from DENV-1__FJ898402__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggaccgccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16471 - RNA, 9879 nt, synthetic construct
  misc_feature 1..9879: note = derived and/or modified CDS sequence (opt4) from DENV-1__FJ898403__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16472 - RNA, 9879 nt, synthetic construct
  misc_feature 1..9879: note = derived and/or modified CDS sequence (opt4) from DENV-1__FJ898404__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16473 - RNA, 9879 nt, synthetic construct
  misc_feature 1..9879: note = derived and/or modified CDS sequence (opt4) from DENV-1__GQ199840__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcaccggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacatccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16474 - RNA, 9879 nt, synthetic construct
  misc_feature 1..9879: note = derived and/or modified CDS sequence (opt4) from DENV-1__FJ898405__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcaacatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16475 - RNA, 9879 nt, synthetic construct
  misc_feature 1..9879: note = derived and/or modified CDS sequence (opt4) from DENV-1__FJ898406__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcaacatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatggccagcatgaagagattcaagaacgagggcgaccccgagggcgccctgtggtga

SEQ ID NO: 16476 - RNA, 9879 nt, synthetic construct
  misc_feature 1..9879: note = derived and/or modified CDS sequence (opt4) from DENV-1__GQ199841__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16477 - RNA, 9879 nt, synthetic construct
  misc_feature 1..9879: note = derived and/or modified CDS sequence (opt4) from DENV-1__FJ898407__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16478 - RNA, 9879 nt, synthetic construct
  misc_feature 1..9879: note = derived and/or modified CDS sequence (opt4) from DENV-1__FJ898408__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgaccccggcgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16479 - RNA, 9879 nt, synthetic construct
  misc_feature 1..9879: note = derived and/or modified CDS sequence (opt4) from DENV-1__GQ199843__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16480 - RNA, 9879 nt, synthetic construct
  misc_feature 1..9879: note = derived and/or modified CDS sequence (opt4) from DENV-1__GQ199844__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16481 - RNA, 9879 nt, synthetic construct
  misc_feature 1..9879: note = derived and/or modified CDS sequence (opt4) from DENV-1__GQ199845__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcatgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagatctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccaccaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16482 - RNA, 9879 nt, synthetic construct
  misc_feature 1..9879: note = derived and/or modified CDS sequence (opt4) from DENV-1__GQ199846__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccatcatggccagagacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16483 - RNA, 9879 nt, synthetic construct
  misc_feature 1..9879: note = derived and/or modified CDS sequence (opt4) from DENV-1__GQ199847__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgaccccgacgactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16484 - RNA, 9879 nt, synthetic construct
  misc_feature 1..9879: note = derived and/or modified CDS sequence (opt4) from DENV-1__GQ199849__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagcagaaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctggccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcctgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagagaaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcttcgtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgccctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16485 - RNA, 9879 nt, synthetic construct
  misc_feature 1..9879: note = derived and/or modified CDS sequence (opt4) from DENV-1__FJ898410__SS-prME
  source 1..9879: mol_type = other RNA
agcgtgaccatgctgctgatgctgacccccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagatctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16486 - RNA, 9879 nt, synthetic construct
  misc_feature 1..9879: note = derived and/or modified CDS sequence (opt4) from DENV-1__FJ898411__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16487 - RNA, 9879 nt, synthetic construct
  misc_feature 1..9879: note = derived and/or modified CDS sequence (opt4) from DENV-1__FJ898412__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgtgaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16488 - RNA, 9879 nt, synthetic construct
  misc_feature 1..9879: note = derived and/or modified CDS sequence (opt4) from DENV-1__GQ199852__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgaccaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgcccctgcactgcgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16489 - RNA, 9879 nt, synthetic construct
  misc_feature 1..9879: note = derived and/or modified CDS sequence (opt4) from DENV-1__FJ898415__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcaacatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagaccatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16490 - RNA, 9879 nt, synthetic construct
  misc_feature 1..9879: note = derived and/or modified CDS sequence (opt4) from DENV-1__FJ898416__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgtgctgtggtga

SEQ ID NO: 16491 - RNA, 9879 nt, synthetic construct
  misc_feature 1..9879: note = derived and/or modified CDS sequence (opt4) from DENV-1__FJ898417__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgaccccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16492 - RNA, 9879 nt, synthetic construct
  misc_feature 1..9879: note = derived and/or modified CDS sequence (opt4) from DENV-1__GQ868612__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcctgatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16493 - RNA, 9879 nt, synthetic construct
  misc_feature 1..9879: note = derived and/or modified CDS sequence (opt4) from DENV-1__FJ898419__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggctggaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16494 - RNA, 9879 nt, synthetic construct
  misc_feature 1..9879: note = derived and/or modified CDS sequence (opt4) from DENV-1__FJ898420__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcagactggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacaagagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16495 - RNA, 9879 nt, synthetic construct
  misc_feature 1..9879: note = derived and/or modified CDS sequence (opt4) from DENV-1__FJ898421__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgagcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcggccccgagggcgccctgtggtga

SEQ ID NO: 16496 - RNA, 9879 nt, synthetic construct
  misc_feature 1..9879: note = derived and/or modified CDS sequence (opt4) from DENV-1__FJ898423__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcatccagtacgagaacctgaagtacagcgtgatcgtgaccgtgcacaccggcgaccagcaccaggtgggcaacgagagcaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccaccggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatggtgagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcacatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16497 - RNA, 9879 nt, synthetic construct
  misc_feature 1..9879: note = derived and/or modified CDS sequence (opt4) from DENV-1__FJ898424__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcaccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16498 - RNA, 9879 nt, synthetic construct
  misc_feature 1..9879: note = derived and/or modified CDS sequence (opt4) from DENV-1__FJ898425__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16499 - RNA, 9879 nt, synthetic construct
  misc_feature 1..9879: note = derived and/or modified CDS sequence (opt4) from DENV-1__FJ898426__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtggccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaagacacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16500 - RNA, 9879 nt, synthetic construct
  misc_feature 1..9879: note = derived and/or modified CDS sequence (opt4) from DENV-1__GQ199856__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctggtggccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatcggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacttcgtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagctgacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16501 - RNA, 9879 nt, synthetic construct
  misc_feature 1..9879: note = derived and/or modified CDS sequence (opt4) from DENV-1__FJ898427__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactgcgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16502 - RNA, 9879 nt, synthetic construct
  misc_feature 1..9879: note = derived and/or modified CDS sequence (opt4) from DENV-1__JF937599__SS-prME
  source 1..9879: mol_type = other RNA
agcgtgaccatgctgctgatgctgatgcccaccgccctggccttccacctgaccgccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgaggtgcagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16503 - RNA, 9879 nt, synthetic construct
  misc_feature 1..9879: note = derived and/or modified CDS sequence (opt4) from DENV-1__FJ898431__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgctgttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16504 - RNA, 9879 nt, synthetic construct
  misc_feature 1..9879: note = derived and/or modified CDS sequence (opt4) from DENV-1__GU131678__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcatgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcaaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcctgctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccccaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgccggcgagagaaacaaccaggtgctggaggagaacatggacgtggagatctggaccaaggagggcgagagaaagaagctgctgcccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatgggcagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggccaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggccccgccaagctgagatggttcgtggagagaaccctggtgaaccccgagggcaaggtgatcgccctgggctgcggcagaggcgcctggagctactactgcgccggcctgaagaagggcaccgaggtgaagggctacaccaagggcggccccggccacgaggagcccatccccatggccacctacggctgggacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggaccccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgccccacctgcgtgtacaacatgatgggcaagagagagaagaagctgggcgagttcggcaaggccaagggcagcagacccatctggtacatgtggctgggcgccagattcctggagttcgaggccctgggcttcatgaacgaggaccactggttcagcagagagaacagcctgagcggcgtggagggcgaggccctgcacaagctgggctacatcctgagagacatcagcaagatccccggcggcaacatgtacgccgacgacaccgccggctgggacaccagaatcaccgaggacgacctgcagaacgagggcaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggaccctgagagagaccgcctgcctgggcaagagctacgcccagatgtggcagctgatgtacttccccagaagagccctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgacccccagagccacctggcccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16505 - RNA, 9879 nt, synthetic construct
  misc_feature 1..9879: note = derived and/or modified CDS sequence (opt4) from DENV-1__GU131679__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaaggcctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacatgctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgagctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagatcgaccccgagggcgccctgtggtga

SEQ ID NO: 16506 - RNA, 9879 nt, synthetic construct
  misc_feature 1..9879: note = derived and/or modified CDS sequence (opt4) from DENV-1__GU131680__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16507 - RNA, 9879 nt, synthetic construct
  misc_feature 1..9879: note = derived and/or modified CDS sequence (opt4) from DENV-1__GU131681__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaaggtgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatgggcgcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16508 - RNA, 9879 nt, synthetic construct
  misc_feature 1..9879: note = derived and/or modified CDS sequence (opt4) from DENV-1__GU131682__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16509 - RNA, 9879 nt, synthetic construct
  misc_feature 1..9879: note = derived and/or modified CDS sequence (opt4) from DENV-1__GU131683__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagacccccgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggcccacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccttcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16510 - RNA, 9879 nt, synthetic construct
  misc_feature 1..9879: note = derived and/or modified CDS sequence (opt4) from DENV-1__GU131684__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcaaggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16511 - RNA, 9879 nt, synthetic construct
  misc_feature 1..9879: note = derived and/or modified CDS sequence (opt4) from DENV-1__GU131685__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggagaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16512 - RNA, 9879 nt, synthetic construct
  misc_feature 1..9879: note = derived and/or modified CDS sequence (opt4) from DENV-1__GQ868614__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggccccttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16513 - RNA, 9879 nt, synthetic construct
  misc_feature 1..9879: note = derived and/or modified CDS sequence (opt4) from DENV-1__GU131688__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccgaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccgccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16514 - RNA, 9879 nt, synthetic construct
  misc_feature 1..9879: note = derived and/or modified CDS sequence (opt4) from DENV-1__GU131689__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatgaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggaggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16515 - RNA, 9879 nt, synthetic construct
  misc_feature 1..9879: note = derived and/or modified CDS sequence (opt4) from DENV-1__GU131690__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16516 - RNA, 9879 nt, synthetic construct
  misc_feature 1..9879: note = derived and/or modified CDS sequence (opt4) from DENV-1__GU131695__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaacctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16517 - RNA, 9879 nt, synthetic construct
  misc_feature 1..9879: note = derived and/or modified CDS sequence (opt4) from DENV-1__GU131697__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagtaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacaagcaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16518 - RNA, 9879 nt, synthetic construct
  misc_feature 1..9879: note = derived and/or modified CDS sequence (opt4) from DENV-1__GU131700__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctgaccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccatgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16519 - RNA, 9879 nt, synthetic construct
  misc_feature 1..9879: note = derived and/or modified CDS sequence (opt4) from DENV-1__GU131701__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccaccgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgccttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacagactgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccggcaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16520 - RNA, 9879 nt, synthetic construct
  misc_feature 1..9879: note = derived and/or modified CDS sequence (opt4) from DENV-1__GU131703__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16521 - RNA, 9879 nt, synthetic construct
  misc_feature 1..9879: note = derived and/or modified CDS sequence (opt4) from DENV-1__GU131706__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcagaaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16522 - RNA, 9879 nt, synthetic construct
  misc_feature 1..9879: note = derived and/or modified CDS sequence (opt4) from DENV-1__GU131708__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccagcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatgggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16523 - RNA, 9879 nt, synthetic construct
  misc_feature 1..9879: note = derived and/or modified CDS sequence (opt4) from DENV-1__GU131710__SS-prME
  source 1..9879: mol_type = other RNA
agcgtgaccatgctgctgatgctgatgcccaccgccctggccttccacctgaccaccagaggcggcgagccccacatgatcgccagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagagaaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16524 - RNA, 9879 nt, synthetic construct
  misc_feature 1..9879: note = derived and/or modified CDS sequence (opt4) from DENV-1__GU131717__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccgaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgcaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccgccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16525 - RNA, 9879 nt, synthetic construct
  misc_feature 1..9879: note = derived and/or modified CDS sequence (opt4) from DENV-1__GU131718__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcatcgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgatcgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16526 - RNA, 9879 nt, synthetic construct
  misc_feature 1..9879: note = derived and/or modified CDS sequence (opt4) from DENV-1__GU131720__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcgccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatgaagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccatcgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16527 - RNA, 9879 nt, synthetic construct
  misc_feature 1..9879: note = derived and/or modified CDS sequence (opt4) from DENV-1__HM181960__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcagagtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16528 - RNA, 9879 nt, synthetic construct
  misc_feature 1..9879: note = derived and/or modified CDS sequence (opt4) from DENV-1__HM181963__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagatcggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaaggtggtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16529 - RNA, 9879 nt, synthetic construct
  misc_feature 1..9879: note = derived and/or modified CDS sequence (opt4) from DENV-1__HM181964__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactgcgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttccccctgagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacaagcagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16530 - RNA, 9879 nt, synthetic construct
  misc_feature 1..9879: note = derived and/or modified CDS sequence (opt4) from DENV-1__HM181966__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcaccctggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatcgccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcttcaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctggtgatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16531 - RNA, 9879 nt, synthetic construct
  misc_feature 1..9879: note = derived and/or modified CDS sequence (opt4) from DENV-1__GU131721__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcgtgcccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgagacccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgagcccgagggcgccctgtggtga

SEQ ID NO: 16532 - RNA, 9879 nt, synthetic construct
  misc_feature 1..9879: note = derived and/or modified CDS sequence (opt4) from DENV-1__GU131723__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16533 - RNA, 9879 nt, synthetic construct
  misc_feature 1..9879: note = derived and/or modified CDS sequence (opt4) from DENV-1__GU131725__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcagcgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagggcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcagaggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16534 - RNA, 9879 nt, synthetic construct
  misc_feature 1..9879: note = derived and/or modified CDS sequence (opt4) from DENV-1__GU131726__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcgccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgctgagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagccccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccatcgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16535 - RNA, 9879 nt, synthetic construct
  misc_feature 1..9879: note = derived and/or modified CDS sequence (opt4) from DENV-1__GU131727__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgtacctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16536 - RNA, 9879 nt, synthetic construct
  misc_feature 1..9879: note = derived and/or modified CDS sequence (opt4) from DENV-1__HM631850__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagccccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcaactggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16537 - RNA, 9879 nt, synthetic construct
  misc_feature 1..9879: note = derived and/or modified CDS sequence (opt4) from DENV-1__KF955446__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccagagccagccaggagggccccctgcccgagatcgaggccgaggtgttcagaaagagaaacctgaccatcatggacctgcaccccggcagcggcaagaccagaagatacctgcccgccatcgtgagagaggccatcaagagaaagctgagaaccctgatcctggcccccaccagagtgggcgccagcgagatggccgaggccctgaagggcatgcccatcagataccagaccaccgccgtgaagagcgagcacaccggcaaggagatcgtggacctgatgggccacgccaccttcaccatgggcctgctggcccccggcagagtgcccaactacaacatggtgatcatggacgaggcccacttcaccgaccccagcagaatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaaccccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgccccctggaccgaggccaagatgctgctggacaacatcaacacccccgagggcatcatccccgccctgttcgagcccgagagagagaagagcgccgccatcgacggcgagagcagactgagaggcgaggccagaaagaccttcgtggagctgatgagaagaggcgacctgcccgtgtggctgagctacaaggtggccagcgagggcttccagtacagcgacagaagatggtgcttcgacggcgagagaaccaaccaggtgctggaggagaacatggccgtggagatctggcccaaggagggcgagagaaagaagctgagacccagatgcctggacgccagaacctacagcgaccccctggccctgagagagttcaaggagttcccccccggcagaagaagcgtgagcggcgacctgatcctggagatcggcaagctgccccaccccctgacccagagaccccagaacgccctggccaccctggtgatgagccacaccagcgagcagggcggcagagcctacagacacgccatggaggagctgcccgccaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagcaacgccaccagacaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggccaagggctggcccatcagcaagatggacatcggcgtgcccctgctggccctgggctgctacagccaggtgaaccccctgaccctgaccgcccccgtgctgatgctggtgccccactaccccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgaccaagagcgagttcaacacctacaagagaagcggcatcatggaggtggacagaagcgaggccaaggagggcctgaagagaggcgagaccaccaagcaccccgtgagcagaggcaccgccaagctgagatggttcgtggagagaaccctggtgaagcccgagggcaaggtgatcgacctgggctgcggcagaggcggctggagctactactgcgccggcctgaagaaggtgaccgaggtgaagggctacaccaagggcggccccggccacgaggaccccatccccatgggcacctacggctggaacctggtgaagctgagaagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatggccagcgtggtggagaccctggagcagatgcagagaaagcacggcggcatgctggtgagaaaccccctgagcagaaacagcacccacgagatgtactgggtgagctggggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgagggcaagcccagcggcagcgccagcagcatggtgaacggcggcgtgaagctgctgaccaagccctgggacggcatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcggcggcatcttcagccccagagagctggagacccccaacctggccgagagagtgctggactgggtggagaagtacggcgtggagagactggagagaatggccatcagcggcgacgactgcctgggcgagcccatctacgacagattcgccaccgccctgaccgccctgaacgacatgggcaaggtgagaaaggacatcccccagtgggagcccagcaagggctggaacgactggcagcagggccccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatggacttccacagaagagacctgagactggccgccaacgccatctggagcgccggccccggcgactggatccccaccagaagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatggccagcatgaagagattcaagaacgagagcgaccccgagggcgccctgtggtga

SEQ ID NO: 16538 - RNA, 9879 nt, synthetic construct
  misc_feature 1..9879: note = derived and/or modified CDS sequence (opt4) from DENV-1__KF921942__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtggccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16539 - RNA, 9879 nt, synthetic construct
  misc_feature 1..9879: note = derived and/or modified CDS sequence (opt4) from DENV-1__JF937602__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16540 - RNA, 9879 nt, synthetic construct
  misc_feature 1..9879: note = derived and/or modified CDS sequence (opt4) from DENV-1__GU131729__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgggcaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggccccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgccagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaccctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgagggcaagcccagcggcagcgccagcagcatgggcaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16541 - RNA, 9879 nt, synthetic construct
  misc_feature 1..9879: note = derived and/or modified CDS sequence (opt4) from DENV-1__GU131730__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgagagccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccaccatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccccaacaaggagggcgaccagtacatctacatgggccagcccctgaacaacgacgaggaccacgccccctggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16542 - RNA, 9879 nt, synthetic construct
  misc_feature 1..9879: note = derived and/or modified CDS sequence (opt4) from DENV-1__GU131731__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaacccacaacaaggagggcgaccagtacatcagcatgggccagcccctgaacaccgccgaggaccacgccccctggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggaccccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16543 - RNA, 9879 nt, synthetic construct
  misc_feature 1..9879: note = derived and/or modified CDS sequence (opt4) from DENV-1__GU131733__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccagagccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacatcgacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16544 - RNA, 9879 nt, synthetic construct
  misc_feature 1..9879: note = derived and/or modified CDS sequence (opt4) from DENV-1__GU131734__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccgaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccgacagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgatcgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccgccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16545 - RNA, 9879 nt, synthetic construct
  misc_feature 1..9879: note = derived and/or modified CDS sequence (opt4) from DENV-1__GU131738__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccggcagaagctggaacagcggctacgagtggatcaccgacttccccggcaagaccgtgtggttcggccccaccatcaagagcggcaacgacatcgccaactgcctgagaaagaacggcaagagagtgatccagctgagcagaaagaccttcgacaccgagtaccagaagaccaagaacaacgactgggactacgtgggcaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctgggccagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16546 - RNA, 9879 nt, synthetic construct
  misc_feature 1..9879: note = derived and/or modified CDS sequence (opt4) from DENV-1__JF937604__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagaccttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcttctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacgccgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagcagggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagccagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16547 - RNA, 9879 nt, synthetic construct
  misc_feature 1..9879: note = derived and/or modified CDS sequence (opt4) from DENV-1__JF937605__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccctgcaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccaacgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16548 - RNA, 9879 nt, synthetic construct
  misc_feature 1..9879: note = derived and/or modified CDS sequence (opt4) from DENV-1__JF937608__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16549 - RNA, 9879 nt, synthetic construct
  misc_feature 1..9879: note = derived and/or modified CDS sequence (opt4) from DENV-1__GU131739__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacacccccaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16550 - RNA, 9879 nt, synthetic construct
  misc_feature 1..9879: note = derived and/or modified CDS sequence (opt4) from DENV-1__GU131740__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgtgccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcttcaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaaggtgtggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga
